United States Patent 11,920,167 (ENGINEERED GLYCOSYLTRANSFERASES AND STEVIOL GLYCOSIDE GLUCOSYLATION METHODS) - sequence listing, part 5

SEQ ID NO: 8435 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8436 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSYLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8437 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgaatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8438 - protein, 793 aa, Artificial Sequence
  "Variant of ADP-beta-1,3-glucosyltransferase"
MIEELRQQLLDDPRSWRAFLRHLVESQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8439 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatataggttggctggcagattttgtggcacatacccaggaagcgatcttccgggatccgtggatggtttttgcgtggcgtctacgtccaggtgtttgggagtatgtgcgcatacatgtagaacagctggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtgcgttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaagatggtacgattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggcgtgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8440 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRALAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGTIHPHWISRFKVWPYLERYASDLEREVKAELGSRPDLIIGNYSDGNLVATLLSEKLGVTQCNIAHALEKSKYLYSDLHWRDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 8441 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaagatggtaggattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggcctgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8442 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8443 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgaatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggagaaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtgcgttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaagatggtaggattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggcgtgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgacatggaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8444 - protein, 793 aa, Artificial Sequence
  "Variant of ADP-beta-1,3-glucosyltransferase"
MIEELRQQLLDDPRSWRAFLRHLVESQRDSWLHTDLQRACKDFREQPPEGYPEDIGWLADFVAHTQEAIFRDPWMVFAWRLRPGVWEYVRIHVEQLAVEKLSTDEYLQAKEQLVGLGAEGEAVLTVDFEDFRPVSRRLRDESTIGDGLTHLNRALAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWRDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDMEATAEKLADFLEAARERPHYWEEISDAALARVSERYTWERYAERLMTIARVFGFWRFVLSRESQVMERYLQMFRHLQWRPLAKAVPME

SEQ ID NO: 8445 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgaatctcagcgtccgtcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggcgtgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8446 - protein, 793 aa, Artificial Sequence
  "Variant of ADP-beta-1,3-glucosyltransferase"
MIEELRQQLLDDPRSWRAFLRHLVESQRPSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWRDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8447 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacggtgttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggcgtgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8448 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDGVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWRDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8449 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8450 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8451 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatgacggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaagatggtaggattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8452 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDDGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 8453 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatgacggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8454 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDDGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8455 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatgacggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8456 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDDGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8457 - DNA, 2379 bp, Artificial Sequence
  "Variant of ADP-beta-1,3-glucosyltransferase"
atgattgaagaactgcgccaacggctgctggatgatccgcgttcatggcgtgcattcctgcgtcatttagtcgaatctcagcgtgactcatggttacatacggatttacagcgcgcgtgcaaagattttcgcgaacagcctccggaaggctatcccgaagatgacggttggctggcagattttgtggcacatacccaggaagcgatcttccgggatccgtggatggtttttgcgtggcgtctacgtccaggtgtttgggagtatgtgcgcatacatgtagaaaccctggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctattccgatggtaggattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattgggtagatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8458 - protein, 793 aa, Artificial Sequence
  "Variant of ADP-beta-1,3-glucosyltransferase"
MIEELRQRLLDDPRSWRAFLRHLVESQRDSWLHTDLQRACKDFREQPPEGYPEDDGWLADFVAHTQEAIFRDPWMVFAWRLRPGVWEYVRIHVETLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYSDGRIHPHWISRFKVWPYLERYASDLEREVKAELGSRPDLIIGNYSDGNLVATLLSEKLGVTQCNIAHALEKSKYLYSDLHWVDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 8459 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtccgtcatggttacatacggatttacagcgcgcgtgcaaagattttcgcgaacagcctccggaaggctatcccgaagatataggttggctggcagattttgtggcacatacccaggaagcgatcttccgggatccgtggatggtttttgcgtggcgtctacgtccaggtgtttgggagtatgtgcgcatacatgtagaacaactggcggtggaggaactgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaagatggtacgattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8460 - protein, 793 aa, Artificial Sequence
  "Variant of ADP-beta-1,3-glucosyltransferase"
MIEELRQQLLDDPRSWRAFLRHLVASQRPSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGTIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADPRTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 8461 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8462 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8463 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatgacggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcacttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaagcctgctgtcagaaaaattaggtgttacgcagtgcaacattgcacatgccctggagaaaagcaagtacctgtattccgatctgcattggcgtgatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 8464 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDDGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVASLLSEKLGVTQCNIAHALEKSKYLYSDLHWRDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 8465 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgggaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgggaagaaatcaggcgtatgcacgagatcatggaccattaccagctggatggtcagctgcgttgggtgggatcgcagctggataaaaccgtcgtgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8466 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8467 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggttttggcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcatgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgggaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacaaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgggaagaaatcatgcgtatgcacgagatcatggaccattaccagctggatggtcagctgcgttgggtgggatcgcagctggataaaaccgtcgtgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8468 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVLAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGMHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHKDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIMRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8469 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcaaccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgggaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8470 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAINRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8471 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttcggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgggaagaaatcaggcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8472 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGFGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8473 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatacctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8474 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYTSDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8475 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcactcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatcaggcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8476 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8477 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcaaccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8478 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAINRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8479 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacattctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacaggaagaaatcaggcgtatgcacgagatcatggaccattaccagctggatggtcagctgcgttgggtgggatcgcagctggataaaaccgtcgtgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8480 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEQEEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8481 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8482 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8483 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8484 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8485 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8486 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8487 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8488 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8489 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8490 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8491 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8492 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8493 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8494 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8495 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8496 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8497 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8498 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8499 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8500 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8501 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8502 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8503 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8504 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8505 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8506 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 8507 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatgaaagcattgcgcccggtggcagcagctacgagagcctggaacgcctggttagctatattagcagcctg

SEQ ID NO: 8508 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDESIAPGGSSYESLERLVSYISSL

SEQ ID NO: 8509 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8510 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8511 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8512 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8513 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaactgtcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8514 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINCHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8515 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8516 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8517 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8518 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8519 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8520 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8521 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatagaagcatttcgcccggtggcagcagctacgagagcctggaacgcctggttagctatattagcagcctg

SEQ ID NO: 8522 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSISPGGSSYESLERLVSYISSL

SEQ ID NO: 8523 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8524 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8525 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8526 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8527 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8528 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8529 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaaacacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8530 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8531 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtatattgaagatgaagttggatgaaagcattgcgcccggtggcagcagctacgagagcctggaacgcctggttagctatattagcagcctg

SEQ ID NO: 8532 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARILKMKLDESIAPGGSSYESLERLVSYISSL

SEQ ID NO: 8533 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8534 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8535 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagtcgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8536 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIESLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8537 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattacgcgtgtgatggttgacccggaaggtgaggttatgcgtcaaaacgcgcgtaaattgaagatgaagttggatgaaagccttgcgcccggtggcagcagctacgagagcctggaacgcctggttagctatattagcagcctg

SEQ ID NO: 8538 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKMKLDESLAPGGSSYESLERLVSYISSL

SEQ ID NO: 8539 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8540 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8541 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaactgtcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaagatgaagttggatagaagcatttcgcccggtggcagcagctacgagagcctggaacgcctggttagctatattagcagcctg

SEQ ID NO: 8542 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINCHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKMKLDRSISPGGSSYESLERLVSYISSL

SEQ ID NO: 8543 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggataccgatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtatattgaagatgaagttggatataagccttgcgcccggtggcagcagctacgagagcctggaacgcctggttagctatattagcagcctg

SEQ ID NO: 8544 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARILKMKLDISLAPGGSSYESLERLVSYISSL

SEQ ID NO: 8545 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcaaaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8546 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8547 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagtcgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8548 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIESLPDGFLGEKGRIVKSCPQQEVLAHKAIGAFWTHGGWNGTMEAVCEGVPMIFSDFGLDQPLNARYMSLVLHVGVYLENGFERGEIINAITRVMVDPEGEVMRQNARKLKDKLDRSIAPGGSSYESLERLVSYISSL

SEQ ID NO: 8549 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgcagattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcaaaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtatattgaaggataagttggatgaaagcattgctcccggtggcagcagctacgagagcctggaacgcctggttagctatattagcagcctg

SEQ ID NO: 8550 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPQINCHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARILKDKLDESIAPGGSSYESLERLVSYISSL

SEQ ID NO: 8551 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8552 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8553 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgcgcccggtggcagcagctacgagagcctggaacgcctggttagctatattagcagcctg

SEQ ID NO: 8554 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8555 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8556 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8557 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8558 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8559 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaactgtcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8560 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINCHGADEFRKELESAMRDSPSDEEVACLITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8561 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8562 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8563 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtatattgaagatgaagttggatgaaagcattgcgcccggtggcagcagctacgagagcctggaacgcctggttagctatattagcagcctg

SEQ ID NO: 8564 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARILKMKLDESIAPGGSSYESLERLVSYISSL

SEQ ID NO: 8565 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagtcgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8566 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIESLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8567 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8568 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8569 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8570 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8571 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8572 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8573 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8574 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPQINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8575 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8576 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8577 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8578 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8579 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8580 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8581 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgcgcccggtggcagcagctacgagagcctggaacgcctggttagctatattagcagcctg

SEQ ID NO: 8582 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8583 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagttgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8584 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8585 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8586 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8587 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8588 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8589 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8590 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8591 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8592 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8593 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtaagagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcaaaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8594 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGKRIPLINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8595 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagctcggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcctggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8596 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSLVLHVGVYLENGFERGEIINAIRRVMVDPEGEVMRQNARKLKDKLDRSIAPGGSSYESLERLVSYISSL

SEQ ID NO: 8597 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8598 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8599 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggataccgatccgagcgttgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8600 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8601 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttccagtttcgttttatcttggacaacgatccgcagccggagtggcttagcaacctgccgacccatggtccgggcgcgggtatgagaatcccgcagattaacaagcacggcgcggatgaattccgtaaagagctggaaagcctcatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8602 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQPEWLSNLPTHGPGAGMRIPQINKHGADEFRKELESLMRDSPSDEEVACVITDALWYFAQPVADSLNLKRLVLMTSSLFNFHALVSLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8603 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccggaaaccagcctttatccgcacttccagtttcgttttatcttggacaacgatccgcagacggagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccagtggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8604 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPETSLYPHFQFRFILDNDPQTEWLRNLPTTGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8605 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgctccgcagccggagtggcttagcaacctgccgacccatggtccgggcgcgggtatgagaatcccgcagattaacaagcacggcgcggatgaattccgtaaagagctggaaagcctcatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgttggtgtgcctgccgaaatttttagagttgggctacctggatccggaagataaacatcgtccggaggaaccggtggtaggtttcccgatgctgaaggttaaagatatccgtcgcgcgtatagccattggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8606 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNAPQPEWLSNLPTHGPGAGMRIPQINKHGADEFRKELESLMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8607 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttccagtttcgttttatcttggacaacgatccgcagccggagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccagtggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8608 - protein, 457 aa, Artificial Sequence
  "Variant of ADP-beta-1,3-glucosyltransferase"
MPNTSPTTVRRRRVILFPVPFPGHLNPMLQLANVLYSRGFAITILHTNFNAPKTSLYPHFQFRFILDNDPQPEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGERGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8609 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccagtggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8610 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8611 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttagcaacctgccgacccatggtccgggcgcgggtatgagaatcccgcagattaacaagcacggcgcggatgaattccgtaaagagctggaaagcctcatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccagtggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8612 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQPEWLSNLPTHGPGAGMRIPQINKHGADEFRKELESLMRDSPSDEEVACVITDALWYFAQPVADSLNLKRLVLMTSSLFNFHALVCLPKFLELGYLDPEDKHRPEEPVVGFPMLKVKDIRRAYSQWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8613 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttccagtttcgttttatcttggacaacgatccgcagccggagtggcttagcaacctgccgaccactggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8614 - protein, 457 aa, Artificial Sequence
  "Variant of ADP-beta-1,3-glucosyltransferase"
MPNTSPTTVRRRRVILFPVPFPGHLNPMLQLANVLYSRGFAITILHTNFNAPKTSLYPHFQFRFILDNDPQPEWLSNLPTTGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8615 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttccagtttcgttttatcttggacaacgatccgcagccggagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8616 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQPEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDRQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8617 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccattggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8618 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8619 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttccagtttcgttttatcttggacaacgatccgcagccggagtggcttagcaacctgccgacccatggtccgggcgcgggtatgagaatcccgcagattaacaagcacggcgcggatgaattccgtaaagagctggaaagcctcatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8620 - protein, 457 aa, Artificial Sequence
  "Variant of ADP-beta-1,3-glucosyltransferase"
MPNTSPTTVRRRRVILFPVPFPGHLNPMLQLANVLYSRGFAITILHTNFNAPKTSLYPHFQFRFILDNDPQPEWLSNLPTHGPGAGMRIPQINKHGADEFRKELESLMRDSPSDEEVACVITDALWYFAQPVADSLNLKRLVLMTSSLFNFHALVSLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGERGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8621 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttccagtttcgttttatcttggacaacgatccgcagaccgagtggcttcgcaacctgccgaccactggtccgggcgcgggtatgagaatcccgcagattaacaagcacggcgcggatgaattccgtaaagagctggaaagcctcatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccagtggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8622 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTTGPGAGMRIPQINKHGADEFRKELESLMRDSPSDEEVACVITDALWYFAQPVADSLNLKRLVLMTSSLFNFHALVCLPKFLELGYLDPEDKHRPEEPVVGFPMLKVKDIRRAYSQWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8623 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8624 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8625 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagacccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8626 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKTLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8627 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggaatagcatccatctggttgagctggcgctgccagaattaccggaactgccaccacattaccatactaccaacggtttaccaccgcatctgaacgggaccctgcacaaggcactgaagatgagcgctcccaacgtcagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8628 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYRNSIHLVELALPELPELPPHYHTTNGLPPHLNGTLHKALKMSAPNVSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8629 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggggaagcatccatctggttgagctggcgctgccagaattaccggaactgccaccacattaccatactaccaacggtttaccaccgcatctgaacgggaccctgcacaaggcactgaagatgagcgctcccaacgtgagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8630 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRGSIHLVELALPELPELPPHYHTTNGLPPHLNGTLHKALKMSAPNVSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8631 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacttcagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8632 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8633 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggggaagcatccatctggttgagctggcgctgccagaattaccggaactgccaccacattaccatactaccaacggtttaccaccgcatctgaacgggaccctgcacaaggcactgaagatgagcgctcccaactttagcaagacccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8634 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRGSIHLVELALPELPELPPHYHTTNGLPPHLNGTLHKALKMSAPNFSKTLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8635 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggggaagcatccatctggttgagctggcgctgccagaattaccggaactgccaccacattaccatactaccaacggtttaccaccgcatctgaacgggaccctgcacaaggcactgaagatgagcgctcccaactttagcaagaaccttcaaaatcttaagccagatctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8636 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRGSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8637 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgtgagcaagacccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattagcggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8638 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKTLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8639 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgtcagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8640 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 8641 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacttgagcaagacccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8642 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNLSKTLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8643 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgtcagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtacgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8644 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8645 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgtgagcaagatccttcaaaatcttaagccggacctggtcctttacgattttctgcaaccgtgggcagaaaaagtctcgcttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8646 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKILQNLKPDLVLYDFLQPWAEKVSLEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8647 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagaaccttcaaaatcttaagccagatctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtacgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaacgcaacgcctacaag

SEQ ID NO: 8648 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNAYK

SEQ ID NO: 8649 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaacgcaacgcctacaag

SEQ ID NO: 8650 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNAYK

SEQ ID NO: 8651 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtctcgcttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8652 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRNSIHLVELALPELPELPPHYHTTNGLPPHLNGTLHKALKMSAPNFSKILQNLKPDLVLYDFLQPWAEKVSLEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8653 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgttagcaagatccttcaagcgcttaaggtcgatctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtacgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8654 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKILQALKVDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8655 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagaaccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaacgcaacgcctacaag

SEQ ID NO: 8656 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNAYK

SEQ ID NO: 8657 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacaggaatagcatccatctggttgagctggcgctgccagaattaccggaactgccaccacattaccatactaccaacggtttaccaccgcatctgaacgggaccctgcacaaggcactgaagatgagcgctcccaacttcagcaagaaccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8658 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRNSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8659 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaacgcaacgcctacaag

SEQ ID NO: 8660 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNAYK

SEQ ID NO: 8661 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagaaccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8662 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8663 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcggtatgtatttagttagcaccgccattaatctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8664 - protein, 450 aa, Artificial Sequence
  "Variant of ADP-beta-1,3-glucosyltransferase"
MHHHHEGVSGQTLRVLMFPWLALGHVNPFLRIAKQLADRGFGMYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8665 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttaacgagcaccgccattcaactcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8666 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLTSTAIQLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8667 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgcccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8668 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPPVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8669 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgcccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8670 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPPVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8671 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaatctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgggtgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8672 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPGVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8673 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8674 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8675 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacactgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgtccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8676 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLHLPELPELPPHYHTTNGLPPHLNGTLHKALKMSAPNFSKILQNLKPDLVLYDFLQPWAEKVALEQGIPSVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8677 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacactggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8678 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8679 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacactggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8680 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8681 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8682 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8683 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaagcactgaagatgagcgctcccaactttagcaagatccttcaaaatcttaagccggacctggtcctttacgattttctgcaaccgtgggcagaaaaagtcgcccttgaacagggcatcccgggtgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8684 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPGVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8685 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacactggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgcccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8686 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLALPELPELPPHYHTTNGLPPHLNGTLHKALKMSAPNFSKILQNLKPDLVLYDFLQPWAEKVALEQGIPPVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8687 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaagcactgaagatgagcgctcccaactttagcaagatccttcaaaatcttaagccggacctggtcctttacgattttctgcaaccgtgggcagaaaaagtcgcccttgaacagggcatcccgtccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8688 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPSVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8689 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacactgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgggtgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8690 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLHLPELPELPPHYHTTNGLPPHLNGTLHKALKMSAPNFSKILQNLKPDLVLYDFLQPWAEKVALEQGIPGVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8691 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccgcccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8692 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNIKPDLVLYDFLQPWAEKVALEQGIPPVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8693 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaatctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8694 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8695 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgtccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8696 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPSVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8697 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgtccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8698 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPSVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8699 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttacttaacaccgccattcaactcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8700 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLLNTAIQLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8701 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgctatccatttagttagcaccgccattaatctcgaaagcatcaaaaagagaatcccggagaaatacagtaatagcatccatctggttacactgcatctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8702 - protein, 450 aa, Artificial Sequence
  "Variant of ADP-beta-1,3-glucosyltransferase"
MHHHHEGVSGQTLRVLMFPWLALGHVNPFLRIAKQLADRGFAIHLVSTAINLESIKKRIPEKYSNSIHLVTLHLPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8703 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgggtgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8704 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPGVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8705 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttaacaccggcattaatctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8706 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVNTGINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8707 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttaacaccgccattgtgctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8708 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVNTAIVLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8709 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaatctcgaaagcatcaaaaagagaatcccggagaaatacagtaatagcatccatctggttacactgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8710 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8711 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttacgtatttagttagcaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccgcccgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8712 - protein, 450 aa, Artificial Sequence
  "Variant of ADP-beta-1,3-glucosyltransferase"
MHHHHEGVSGQTLRVLMFPWLALGHVNPFLRIAKQLADRGFVTYLVSTAINLESIKKRIPEKYSNSIHLVELHLPELPELPPHYHTTNGLPPHLNGTLHKALKMSAPNFSKILQNLKPDLVLYDFLQPWAEKVALEQGIPPVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8713 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacctcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8714 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNLPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8715 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattacgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8716 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEITQVLKDVISGPTGEILRAKVRDISKRLRARREEEMNAAAEELIQLCRNRNAYK

SEQ ID NO: 8717 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8718 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNAYK

SEQ ID NO: 8719 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttgaagcaatccatctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8720 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFEAIHLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8721 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattatgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8722 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIMQVLKDVISGPTGEILRAKVRDISKRLRARREEEMNAAAEELIQLCRNRNAYK

SEQ ID NO: 8723 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8724 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNAYK

SEQ ID NO: 8725 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8726 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIAQVLKDVISGPTGEILRAKVRDISKRLRARREEEMNAAAEELIQLCRNRNAYK

SEQ ID NO: 8727 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattaggcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8728 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIRQVLKDVISGPTGEILRAKVRDISKRLRARREEEMNAAAEELIQLCRNRNAYK

SEQ ID NO: 8729 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacatgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8730 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNMNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8731 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaagtcctgaaagatgtgatttcgggcccgactggtgagatactgcgcgcgaaagtacgcgactttagcaaacgcctgagagcgagacgcgaggaggaaatgaacgcagcggcggaagaactgatacagctgtgtcgcaaccgcaacgcctacaag

SEQ ID NO: 8732 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDFSKRLRARREEEMNAAAEELIQLCRNRNAYK

SEQ ID NO: 8733 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8734 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNAYK

SEQ ID NO: 8735 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttgaagcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8736 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILKVLKDVISGPTGEILRAKVRDISKRLRARREEEMNAAAEELIQLCRNRNAYK

SEQ ID NO: 8737 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacctcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8738 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNLNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNAYK

SEQ ID NO: 8739 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8740 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMQVLKDVISGPTGEILRAKVRDISKRLRARREEEMNAAAEELIQLCRNRNAYK

SEQ ID NO: 8741 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgactttagcaaacggctgagagcgagacgcgaggaggaaatgaacgcagcggcggaagaactgatacagctgtgtcgcaaccgcaacgcctacaag

SEQ ID NO: 8742 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDFSKRLRARREEEMNAAAEELIQLCRNRNAYK

SEQ ID NO: 8743 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattacgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8744 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEITKVLKDVISGPTGEILRAKVRDISKRLRARREEEMNAAAEELIQLCRNRNAYK

SEQ ID NO: 8745 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8746 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8747 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttgaagcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattacgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8748 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEITQVLKDVISGPTGEILRAKVRDISKRLRARREEEMNAAAEELIQLCRNRNAYK

SEQ ID NO: 8749 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttgaagcaatccatctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8750 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIHLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8751 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttccggcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8752 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8753 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattgcgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8754 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIAKVLKDVISGPTGEILRAKVRDISKRLRARREEEMNAAAEELIQLCRNRNAYK

SEQ ID NO: 8755 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattaagcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8756 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIKQVLKDVISGPTGEILRAKVRDISKRLRARREEEMNAAAEELIQLCRNRNAYK

SEQ ID NO: 8757 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttgaagcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8758 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8759 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttcctgcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8760 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIAQVLKDVISGPTGEILRAKVRDISKRLRARREEEMNAAAEELIQLCRNRNAYK

SEQ ID NO: 8761 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8762 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIAQVLKDVISGPTGEILRAKVRDISKRLRARREEEMNAAAEELIQLCRNRNAYK

SEQ ID NO: 8763 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgataccgtgggcagaaaaagtcgcccttgaacagggcatcccggctgttccggttctaaccagtggtgcggcactgtttagctactttttcaacttcctgaagcgaccgggtcacgagtttccgtttgaagcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattatgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8764 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIMKVLKDVISGPTGEILRAKVRDISKRLRARREEEMNAAAEELIQLCRNRNAYK

SEQ ID NO: 8765 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8766 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDISKRLRARREEEMNAAAEELIQLCRNRNAYK

SEQ ID NO: 8767 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8768 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILKVLKDVISGPTGEILRAKVRDISKRLRARREEEMNAAAEELIQLCRNRNAYK

SEQ ID NO: 8769 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttgaagcaatccatctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8770 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIHLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDISKRLRARREEEMNAAAEELIQLCRNRNAYK

SEQ ID NO: 8771 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattctgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8772 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEILQVLKDVISGPTGEILRAKVRDISKRLRARREEEMNAAAEELIQLCRNRNAYK

SEQ ID NO: 8773 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttgaagcaatccatctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8774 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIHLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8775 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8776 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8777 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8778 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8779 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8780 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8781 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttgaagcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8782 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDISKRLRARREEEMNAAAEELIQLCRNRNAYK

SEQ ID NO: 8783 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattaggaaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8784 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIRKVLKDVISGPTGEILRAKVRDISKRLRARREEEMNAAAEELIQLCRNRNAYK

SEQ ID NO: 8785 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttagtgaattaggcgtggcagtggagatcgtgcgtgatgaagatggccggattcaccgcggcgaaattctgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8786 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLSELGVAVEIVRDEDGRIHRGEILQVLKDVISGPTGEILRAKVRDISKRLRARREEEMNAAAEELIQLCRNRNAYK

SEQ ID NO: 8787 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgcaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8788 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILQVLKDVISGPTGEILRAKVRDISKRLRARREEEMNAAAEELIQLCRNRNAYK

SEQ ID NO: 8789 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttgaagcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8790 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8791 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacagcaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgactttagcaaactgctgagagcgagccgcgaggaggaaatgaacgcagcggcggaagaactgatacagctgtgtcgcaaccgcaacgcctacaag

SEQ ID NO: 8792 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDFSKLLRASREEEMNAAAEELIQLCRNRNAYK

SEQ ID NO: 8793 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttcctgcaatccgtctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgcaagtcctgaaagatgtgatttcgggcccgactggtgagatactgcgcgcgaaagtacgcgacattagcaaacgcctgagagcgagccgcgaggaggaaatgaacgcagcggcggaagaactgatacagctgtgtcgcaaccgcaacgcctacaag

SEQ ID NO: 8794 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILQVLKDVISGPTGEILRAKVRDISKRLRASREEEMNAAAEELIQLCRNRNAYK

SEQ ID NO: 8795 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttgaagcaatccatctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtcccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgaaagtcctgaaagatgtgatttcgggcccgactggtgagatactgcgcgcgaaagtacgcgactttagcaaactgctgagagcgagccgcgaggaggaaatgaacgcagcggcggaagaactgatacagctgtgtcgcaaccgcaacgcctacaag

SEQ ID NO: 8796 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIHLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILKVLKDVISGPTGEILRAKVRDFSKLLRASREEEMNAAAEELIQLCRNRNAYK

SEQ ID NO: 8797 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8798 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8799 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8800 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8801 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8802 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8803 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8804 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8805 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcgaagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8806 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8807 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8808 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8809 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8810 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8811 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8812 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8813 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8814 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8815 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8816 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8817 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8818 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8819 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8820 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8821 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8822 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8823 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8824 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8825 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8826 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8827 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8828 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGTHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8829 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8830 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8831 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8832 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8833 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8834 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8835 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8836 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8837 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8838 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8839 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8840 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8841 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8842 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8843 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8844 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8845 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8846 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8847 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8848 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8849 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8850 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8851 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8852 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8853 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8854 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8855 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8856 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8857 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8858 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8859 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8860 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8861 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8862 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8863 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8864 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8865 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8866 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8867 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8868 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8869 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8870 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8871 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8872 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8873 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8874 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8875 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8876 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8877 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8878 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8879 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8880 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8881 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8882 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8883 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8884 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8885 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8886 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8887 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8888 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8889 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8890 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8891 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8892 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8893 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8894 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8895 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8896 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8897 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8898 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8899 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8900 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8901 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8902 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8903 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8904 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8905 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8906 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8907 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8908 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8909 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8910 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8911 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8912 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8913 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8914 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8915 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8916 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8917 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8918 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8919 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8920 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8921 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8922 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8923 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8924 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8925 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8926 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8927 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8928 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8929 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8930 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8931 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8932 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8933 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8934 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVETLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8935 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8936 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8937 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8938 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8939 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8940 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8941 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8942 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8943 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8944 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8945 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8946 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8947 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8948 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8949 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8950 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVETLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8951 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8952 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8953 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8954 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8955 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8956 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8957 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8958 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8959 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8960 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8961 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8962 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8963 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8964 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8965 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8966 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8967 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8968 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8969 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8970 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8971 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8972 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8973 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8974 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8975 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8976 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8977 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8978 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8979 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8980 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8981 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8982 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8983 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8984 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8985 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8986 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8987 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8988 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8989 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8990 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8991 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8992 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8993 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8994 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8995 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8996 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8997 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 8998 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 8999 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9000 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9001 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9002 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9003 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9004 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9005 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9006 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9007 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9008 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9009 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9010 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9011 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9012 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9013 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9014 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9015 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9016 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9017 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9018 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9019 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9020 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9021 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9022 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9023 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9024 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9025 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9026 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9027 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggacaattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9028 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDNYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9029 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9030 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9031 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9032 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9033 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9034 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9035 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9036 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9037 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9038 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9039 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtggcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9040 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9041 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9042 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9043 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9044 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9045 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9046 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9047 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9048 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9049 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9050 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9051 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9052 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9053 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9054 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9055 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9056 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9057 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9058 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9059 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9060 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9061 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9062 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9063 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9064 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9065 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9066 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9067 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9068 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9069 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9070 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9071 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9072 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9073 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9074 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9075 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaaaccctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9076 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVETLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9077 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9078 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9079 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9080 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9081 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9082 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9083 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9084 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9085 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9086 - protein, 793 aa, Artificial Sequence
  "Variant of ADP-beta-1,3-glucosyltransferase"
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9087 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9088 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9089 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9090 - protein, 793 aa, Artificial Sequence
  "Variant of ADP-beta-1,3-glucosyltransferase"
MIEELRQQLLDNPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9091 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgtcgtaccgatggag

SEQ ID NO: 9092 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHVVPME

SEQ ID NO: 9093 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgcgcagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcacccatcgtctggataaccagaatctgatgctgagcaacggcaataccgattttgactctttacgtcaaaccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9094 - protein, 793 aa, Artificial Sequence
  "Variant of ADP-beta-1,3-glucosyltransferase"
MIEELRQQLLDSPRSWRAFLRHLVASQRDSWLHTDLQRACKTFRAQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGTHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9095 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9096 - protein, 793 aa, Artificial Sequence
  "Variant of ADP-beta-1,3-glucosyltransferase"
MIEELRQQLLDNPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQLRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9097 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaagccgtacaatatctgggcaccttaccaaaagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9098 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLKDESTIGDGLTHLNRHLAGRIWTDLAAGRSQILEFLGLHRLDNQNLMLSNGNTDFDSLRQAVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9099 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggaaaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 9100 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVENSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 9101 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgaatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcatgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaacgcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9102 - protein, 793 aa, Artificial Sequence
  "Variant of ADP-beta-1,3-glucosyltransferase"
MIEELRQQLLDDPRSWRAFLRHLVESQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGMHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSYLWPEIERLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9103 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtgcattagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatcgtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaagccgtaccgatggag

SEQ ID NO: 9104 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRALAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSYLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADRRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAKAVPME

SEQ ID NO: 9105 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggctttggtgcagaaggtgaagctgttctgacggtggatttcgaagattttcgtccggtgagccgtcgtttacgcgacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcctcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggcgggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 9106 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGFGAEGEAVLTVDFEDFRPVSRRLRDENTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWRDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 9107 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggcgccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9108 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLAPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9109 - DNA, 1350 bp, Artificial Sequence
  "Variant of ADP-beta-1,3-glucosyltransferase"
atgcaccatcatcatgaaggcgtgagcggccagaccctgagagtaactatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9110 - protein, 450 aa, Artificial Sequence
  "Variant of ADP-beta-1,3-glucosyltransferase"
MHHHHEGVSGQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9111 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgttctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9112 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9113 - DNA, 1350 bp, Artificial Sequence
  "Variant of ADP-beta-1,3-glucosyltransferase"
atgcaccatcatcatgaaggcgtgagcggccagaccctgagattgctgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccacggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9114 - protein, 450 aa, Artificial Sequence
  "Variant of ADP-beta-1,3-glucosyltransferase"
MHHHHEGVSGQTLRLLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHHGEIAQVLKDVISGPTGEILRAKVRDISKRLRARREEEMNAAAEELIQLCRNRNAYK

SEQ ID NO: 9115 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtccttgctgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9116 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLADFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9117 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggttatatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9118 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGYMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9119 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttggtctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9120 - protein, 450 aa, Artificial Sequence
  "Variant of ADP-beta-1,3-glucosyltransferase"
MHHHHEGVSGQTLRVLMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9121 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttggggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9122 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVGVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9123 - DNA, 1350 bp, Artificial Sequence
  "Variant of ADP-beta-1,3-glucosyltransferase"
atgcaccatcatcatgaaggcgtgagcggccagaccctgagagtagcgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9124 - protein, 450 aa, Artificial Sequence
  "Variant of ADP-beta-1,3-glucosyltransferase"
MHHHHEGVSGQTLRVAMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9125 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttcgtgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9126 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVRVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9127 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctcagaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9128 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPQNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9129 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgatttgctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9130 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDLLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9131 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgtctctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9132 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPSLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9133 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttgttaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9134 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFVNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9135 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatggttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9136 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEWFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9137 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggggccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9138 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLGPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9139 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccaagatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9140 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAKIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9141 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccattgtctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9142 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHCLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9143 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcctggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9144 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVLESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9145 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaaatggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9146 - protein, 450 aa, Artificial Sequence
  "Variant of ADP-beta-1,3-glucosyltransferase"
MHHHHEGVSGQTLRVLMFPWLALGHVNPFLRIAKQMADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9147 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccgcgatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9148 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAAIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9149 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9150 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9151 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggctctgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9152 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGSAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9153 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccggctctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9154 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPALNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9155 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggtgccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9156 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9157 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgggtctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9158 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPGLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9159 - DNA, 1350 bp, Artificial Sequence
  "Variant of ADP-beta-1,3-glucosyltransferase"
atgcaccatcatcatgaaggcgtgagcggccagaccctgagagtaggtatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9160 - protein, 450 aa, Artificial Sequence
  "Variant of ADP-beta-1,3-glucosyltransferase"
MHHHHEGVSGQTLRVGMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9161 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacatggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9162 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAHGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9163 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccaatatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtccgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9164 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNANIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9165 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccggctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9166 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDRLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9167 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggctatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9168 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGYAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9169 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtccttcttgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgtacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggcgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9170 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLLDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9171 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgcccttatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9172 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNALIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9173 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtccttgtggattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9174 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLVDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9175 - DNA, 1350 bp, Artificial Sequence
  "Variant of ADP-beta-1,3-glucosyltransferase"
atgcaccatcatcatgaaggcgtgagcggccagacccagagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9176 - protein, 450 aa, Artificial Sequence
  "Variant of ADP-beta-1,3-glucosyltransferase"
MHHHHEGVSGQTQRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9177 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtgcgatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9178 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGAMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9179 - DNA, 1350 bp, Artificial Sequence
  "Variant of ADP-beta-1,3-glucosyltransferase"
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9180 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9181 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttcggattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9182 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLSDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9183 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgcagctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9184 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPQLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9185 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttaatacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9186 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFNTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9187 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtccttggtgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9188 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLGDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9189 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttctgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9190 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLSDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9191 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacatgaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9192 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNMTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9193 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcctggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9194 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVLESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9195 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgcgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagcctattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9196 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNANFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9197 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggatatgagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9198 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGYEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9199 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcacgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9200 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGITLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9201 - DNA, 1350 bp, Artificial Sequence
  "Variant of ADP-beta-1,3-glucosyltransferase"
atgcaccatcatcatgaaggcgtgagcggccagaccctgcaggtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9202 - protein, 450 aa, Artificial Sequence
  "Variant of ADP-beta-1,3-glucosyltransferase"
MHHHHEGVSGQTLQVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9203 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggccgggccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9204 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGRAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9205 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacgctttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9206 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNALPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9207 - DNA, 1350 bp, Artificial Sequence
  "Variant of ADP-beta-1,3-glucosyltransferase"
atgcaccatcatcatgaaggcgtgagcggccagaccctgagagcgctgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9208 - protein, 450 aa, Artificial Sequence
  "Variant of ADP-beta-1,3-glucosyltransferase"
MHHHHEGVSGQTLRALMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9209 - DNA, 1350 bp, Artificial Sequence
  "Variant of ADP-beta-1,3-glucosyltransferase"
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcggtgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9210 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGGAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9211 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtccttaatgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9212 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLNDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9213 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggttcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9214 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGSALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9215 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaggggagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9216 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGGEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9217 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcggggccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9218 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGGAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9219 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcccggccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9220 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGPAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9221 - DNA, 1350 bp, Artificial Sequence
  "Variant of ADP-beta-1,3-glucosyltransferase"
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 9222 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 9223 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctggatgatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9224 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLDDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9225 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtttgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9226 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRLMVDPEGEVMRQNARKLKDKLDRSIAPGGSSYESLERLVSYISSL

SEQ ID NO: 9227 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 9228 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 9229 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgggggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9230 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLGDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9231 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgccgagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9232 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRAPSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9233 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatacgccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9234 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDTPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9235 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcactctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9236 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSTLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9237 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttacgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9238 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFTGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 9239 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccggtctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 9240 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTGLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL
